United States Patent
Zhu et al.

(10) Patent No.: US 12,428,630 B2
(45) Date of Patent: Sep. 30, 2025

(54) TAQ DNA POLYMERASE VARIANTS WITH INCREASED REVERSE TRANSCRIPTASE ACTIVITY

(71) Applicant: AbClonal Science Inc., Woburn, MA (US)

(72) Inventors: Zhenyu Zhu, Lynnfield, MA (US); Dapeng Sun, Lexington, MA (US); Aine Quimby, Newburyport, MA (US); Nicholas J. DeBerardinis, Melrose, MA (US); Krista Ferrari, Dunstable, MA (US)

(73) Assignee: AbClonal Science, Inc., Woburn, MA (US)

( * ) Notice: Subject to any disclaimer, the term of this patent is extended or adjusted under 35 U.S.C. 154(b) by 348 days.

(21) Appl. No.: 18/323,660

(22) Filed: May 25, 2023

(65) Prior Publication Data

US 2024/0392264 A1 Nov. 28, 2024

(51) Int. Cl.
| | | |
|---|---|---|
| C12N 9/12 | (2006.01) | |
| C12N 15/63 | (2006.01) | |
| C12Q 1/686 | (2018.01) | |

(52) U.S. Cl.
CPC .......... *C12N 9/1252* (2013.01); *C12N 15/63* (2013.01); *C12Q 1/686* (2013.01); *C12Y 207/07007* (2013.01)

(58) Field of Classification Search
None
See application file for complete search history.

(56) References Cited

U.S. PATENT DOCUMENTS

| | | |
|---|---|---|
| 10,920,202 B1 | 2/2021 | Zhu |
| 10,947,518 B1 | 3/2021 | Zhu |
| 11,020,474 B1 | 6/2021 | Xiang |
| 2020/0283825 A1 | 9/2020 | Zhu |
| 2020/0291455 A1 | 9/2020 | Zhu |
| 2020/0362320 A1 | 11/2020 | Zhu |
| 2021/0079365 A1 | 3/2021 | Zhu |
| 2021/0087550 A1 | 3/2021 | Zhu |
| 2021/0171925 A1 | 6/2021 | Zhu |
| 2021/0403537 A1 | 12/2021 | Xiang |
| 2022/0064268 A1 | 3/2022 | Xlang |
| 2022/0106576 A1 | 4/2022 | Zhu |
| 2023/0033390 A1 | 2/2023 | Xiang |
| 2023/0094503 A1 | 3/2023 | Zhu |
| 2023/0111383 A1 | 4/2023 | Zhu |
| 2023/0212550 A1 | 7/2023 | Zhu |
| 2023/0265412 A1 | 8/2023 | Zhu |
| 2023/0295707 A1 | 9/2023 | Zhu |
| 2024/0052326 A1 | 2/2024 | Zhu |
| 2024/0067951 A1 | 2/2024 | DiCicco |
| 2024/0124854 A1 | 4/2024 | Zhu |
| 2024/0247246 A1 | 7/2024 | Sun |
| 2024/0279826 A1 | 8/2024 | Sun |
| 2024/0392264 A1 | 11/2024 | Zhu |
| 2024/0392267 A1 | 11/2024 | Zhu |
| 2024/0392276 A1 | 11/2024 | Sun |
| 2024/0392336 A1 | 11/2024 | Sun |
| 2025/0051739 A1 | 2/2025 | Zhu |
| 2025/0223574 A1 | 7/2025 | Zhu |
| 2025/0236860 A1 | 7/2025 | Sun |

OTHER PUBLICATIONS

Singh et al. (Curr. Protein Pepto. Sci. 18:1-11, 2017.*
Zhang et al. (Structure 26: 1474-1485, 2018.*
Franceus et al., J. Ind. Microbiol. Biotechnol. vol. 44, pp. 687-695, 2017.*
Ngo et al. in The Protein Folding Problem and Tertiary Structure Prediction, 1994, Merz et al. (ed.), Birkhauser, Boston, MA, pp. 433 and 492-495.*

* cited by examiner

*Primary Examiner* — Richard G Hutson
(74) *Attorney, Agent, or Firm* — Eric P. Mirabel

(57) ABSTRACT

Taq DNA polymerase mutants exhibiting reverse transcriptase activity compared to wild type polymerase were engineered, characterized, and selected via polymerase chain reactions visualized via electrophoresis on agarose gels. Initial screening was followed up with probe-based qualitative, real-time PCR (qPCR) with a typical reverse transcription cycling protocol to detect specified ribonucleic acid (RNA) target sequences. The engineered variants can render robust cDNA from RNA target substrates and amplify that cDNA under standard reaction conditions without the assistance of added reverse transcriptase enzymes.

10 Claims, 5 Drawing Sheets
Specification includes a Sequence Listing.

TAQ DNA POLYMERASE VARIANTS WITH INCREASED REVERSE TRANSCRIPTASE ACTIVITY

SEQUENCE LISTING

The instant application contains a Sequence Listing which has been submitted electronically in ASCII format and is hereby incorporated by reference in its entirety. Said ASCII copy, created on Apr. 21, 2022 is named ABcl-TaqRT (generic)_SL.txt and is 1.653 megabytes in size.

BACKGROUND

Real-time RT-PCR is a method used to detect RNA in samples via detecting increased fluorescent signal over time as amplicons are generated in a qPCR reaction. Currently, the most widely known application of RT-PCR is to detect viral genetic material, such as the presence of SARS-COV2 (COVID-19), in patient samples during diagnostic laboratory assays. RT-PCR is the standard of detection of RNA targets for molecular biology, medical, and forensic research.

Taq DNA polymerase is commonly used in molecular biology for extending nucleic acid amplicons in polymerase chain reactions (PCR). In PCR, designated segments of DNA (amplicons) are amplified by the repeated cycling of three steps: denaturation, annealing, and elongation/extension of the amplicon. With qualitative, real-time PCR (qPCR), fluorescent signal generated through dyes or probes allows for data collection during PCR cycling so that target amplification can be measured and recorded. Probe-based chemistries utilize fluorescently labeled, target-specific probes which only release a reporter dye when bound to target sequence, allowing for real-time detection of target amplification as fluorescent signal intensity increases.

RT-PCR allows for the detection and amplification of RNA substrates. When a reverse transcriptase enzyme is included in a qPCR reaction, detection of RNA is enabled via an additional initial cycling step in which the reverse transcriptase generates complementary DNA (cDNA) to the RNA substrate; the cDNA can then be amplified for quantification by the accompanying DNA polymerase. Current RT-PCR protocols rely upon the combination of reverse transcriptase and polymerase enzymes to generate data. Under most conditions, Taq polymerase is limited to the amplification of DNA substates; the few examples in which is it able to generate cDNA from RNA substrates typically rely on very specific buffers and protocols[1,2], or on a mutation of the aspartic acid at amino acid position 732. Overall, Taq activity in those instances is not typically as robust as that of a reverse transcriptase enzyme. In the interest of creating a more reliable Taq polymerase with inherent reverse transcriptase activity, Taq DNA polymerase mutants were generated using site-directed mutagenesis, and among them, a number of mutants are found to be able to convert RNA substrates rapidly and consistently to a DNA product for PCR or RT-PCR purposes.

SUMMARY

The invention relates to engineered Taq DNA polymerase mutants exhibiting greater reverse transcriptase activity compared to wild type polymerase. The Taq DNA polymerase mutants listed in the Description of the Figures and the Detailed Description, wherein each has a tag sequence: GSGSSGHHHHHH (SEQ ID NO: 315) added at the C-Terminus, and each has a substitution at the position indicated (and wherein each mutant's DNA sequence is the odd-numbered sequence identification number following it, and each mutants' amino acid sequence is the even-numbered identification number following it) were identified as having such enhanced reverse transcriptase activity. The invention further includes Taq DNA polymerase amino acid sequences with at least one of the mutations above, but wherein the remainder of the Taq DNA polymerase mutant amino acid sequence only has conservative substitutions such that the molecule has at least 70%, 80%, 90%, 95%, 96%, 97%, 98% or 99% identity to the corresponding Taq DNA polymerase mutant amino acid sequence in the sequence listing (hereinafter referred to as "Variant Sequences").

The invention further includes the DNA sequences preceding each of the amino acid sequences for the mutants above (i.e., respectively, SEQ ID NOS:) and further includes the foregoing DNA sequences and other degenerate nucleic acid sequences (collectively the "Degenerate Nucleic Acid Sequences") encoding (i) each of the above Taq DNA polymerase mutants, and (ii) the amino acid sequences of any of the Variant Sequences.

The invention further includes vectors incorporating any Degenerate Nucleic Acid Sequences; and cells transformed with any such vectors or Degenerate Nucleic Acid Sequences and capable of expressing any of the above Taq DNA polymerase mutant amino acid sequences or Variant Sequences.

The invention further includes a composition or a kit comprising any of the above Taq DNA polymerase mutant amino acid sequences or Variant Sequences, Degenerate Nucleic Acid Sequences, or vectors incorporating such Degenerate Nucleic Acid Sequences. The invention also includes a process of amplifying a target nucleic acid, wherein any of the above Taq DNA polymerase mutants or Variant Sequences are employed in a reaction mixture designed to amplify a target nucleic acid, and subjecting the reagent mixture to conditions for amplification of the target nucleic acid.

Unlike wild-type Taq DNA Polymerase, which displays limited reverse transcriptase activity only under very stringent reaction conditions, the engineered variants can render robust cDNA from RNA target substrates and amplify that cDNA under standard reaction conditions without the assistance of added reverse transcriptase enzymes. Removing the requirement for an additional reverse transcriptase to the qPCR protocol can significantly boost the efficiency of detecting target ribonucleic acids via RT-qPCR, while also reducing protocol complexity, allowing for increased protocol optimization, and unifying buffer composition to that which is most efficient for a single enzyme.

BRIEF DESCRIPTION OF THE FIGURES

FIG. 1 shows a gel indicating the activity comparison of reverse transcriptase WT (SEQ ID NO: 1; SEQ ID NO: 2) and the following mutants: E9K (SEQ ID NO: 3; SEQ ID NO: 4), L15S (SEQ ID NO: 5; SEQ ID NO: 6), D18R (SEQ ID NO: 7; SEQ ID NO: 8), H20E (SEQ ID NO: 9; SEQ ID NO: 10), H21E (SEQ ID NO: 11; SEQ ID NO: 12), K31E (SEQ ID NO: 13; SEQ ID NO: 14), R37D (SEQ ID NO: 15; SEQ ID NO: 16), F66A (SEQ ID NO: 17; SEQ ID NO: 18), K82E (SEQ ID NO: 19; SEQ ID NO: 20), A83F (SEQ ID NO: 21; SEQ ID NO: 22), R85D (SEQ ID NO: 23; SEQ ID NO: 24), P87G (SEQ ID NO: 25; SEQ ID NO: 26), P89G (SEQ ID NO: 27; SEQ ID NO: 28), E90K (SEQ ID NO: 29; SEQ ID NO: 30), F92A (SEQ ID NO: 31; SEQ ID NO: 32), I99S (SEQ ID NO: 33; SEQ ID NO: 34), E101K (SEQ ID NO: 35; SEQ ID NO: 36), L102S (SEQ ID NO: 37; SEQ ID NO: 38), L108S (SEQ ID NO: 39; SEQ ID NO: 40), A109F (SEQ ID NO: 41; SEQ ID NO: 42), R110D (SEQ ID NO: 43; SEQ ID NO: 44), G115P (SEQ ID NO: 45; SEQ ID NO: 46), S124I (SEQ ID NO: 47; SEQ ID NO: 48), I138S (SEQ ID NO: 49; SEQ ID NO: 50), V155S (SEQ ID NO: 51; SEQ ID NO: 52), and L156S (SEQ ID NO: 53; SEQ ID NO: 54).

FIG. 2: shows a gel indicating the activity comparison of reverse transcriptase WT (SEQ ID NO: 1; SEQ ID NO: 2) and the following mutants: H157E (SEQ ID NO: 55; SEQ ID NO: 56), T164I (SEQ ID NO: 57; SEQ ID NO: 58), L168S (SEQ ID NO: 59; SEQ ID NO: 60), R183D (SEQ ID NO: 61; SEQ ID NO: 62), G187P (SEQ ID NO: 63; SEQ ID NO: 64), E189A (SEQ ID NO: 65; SEQ ID NO: 66), E189I (SEQ ID NO: 67; SEQ ID NO: 68), E189K (SEQ ID NO: 69; SEQ ID NO: 70), E189S (SEQ ID NO: 71; SEQ ID NO: 72), K202E (SEQ ID NO: 73; SEQ ID NO: 74), L233S (SEQ ID NO: 85; SEQ ID NO: 86), E230A (SEQ ID NO: 75; SEQ ID NO: 76), E230C (SEQ ID NO: 77; SEQ ID NO: 78), E230M (SEQ ID NO: 79; SEQ ID NO: 80), E230Q (SEQ ID NO: 81; SEQ ID NO: 82), E230V (SEQ ID NO: 83; SEQ ID NO: 84), L233S (SEQ ID NO: 85; SEQ ID NO: 86), H235E (SEQ ID NO: 87; SEQ ID NO: 88), M236S (SEQ ID NO: 89; SEQ ID NO: 90), D237R (SEQ ID NO: 91; SEQ ID NO: 92), D244R (SEQ ID NO: 93; SEQ ID NO: 94), K247E (SEQ ID NO: 95; SEQ ID NO: 96), L281S (SEQ ID NO: 97; SEQ ID NO: 98), P291G (SEQ ID NO: 99; SEQ ID NO: 100), L294S (SEQ ID NO: 101; SEQ ID NO: 102), V310S (SEQ ID NO: 103; SEQ ID NO: 104), K314E (SEQ ID NO: 105; SEQ ID NO: 106), R349D (SEQ ID NO: 107; SEQ ID NO: 108), L379S (SEQ ID NO: 109; SEQ ID NO: 110), S383I (SEQ ID NO: 111; SEQ ID NO: 112), Y394A (SEQ ID NO: 113; SEQ ID NO: 114), G395P (SEQ ID NO: 115; SEQ ID NO: 116), and A442F (SEQ ID NO: 117; SEQ ID NO: 118).

FIG. 3: shows a gel indicating the activity comparison of reverse transcriptase WT (SEQ ID NO: 1; SEQ ID NO: 2) and the following mutants: E507G (SEQ ID NO: 119; SEQ ID NO: 120), E507I (SEQ ID NO: 121; SEQ ID NO: 122), E507L (SEQ ID NO: 123; SEQ ID NO: 124), E537W (SEQ ID NO: 125; SEQ ID NO: 126), T544I (SEQ ID NO: 127; SEQ ID NO: 128), P550G (SEQ ID NO: 129; SEQ ID NO: 130), D578F (SEQ ID NO: 131; SEQ ID NO: 132), D578R (SEQ ID NO: 133; SEQ ID NO: 134), D578T (SEQ ID NO: 135; SEQ ID NO: 136), D578Y (SEQ ID NO: 137; SEQ ID NO: 138), D732A (SEQ ID NO: 139; SEQ ID NO: 140), D732F (SEQ ID NO: 141; SEQ ID NO: 142), D732G (SEQ ID NO: 143; SEQ ID NO: 144), D732I (SEQ ID NO: 145; SEQ ID NO: 146), D732P (SEQ ID NO: 147; SEQ ID NO: 148), D732Q (SEQ ID NO: 149; SEQ ID NO: 150), D732S (SEQ ID NO: 151; SEQ ID NO: 152), E742A (SEQ ID NO: 153; SEQ ID NO: 154), E742G (SEQ ID NO: 155; SEQ ID NO: 156), E742H (SEQ ID NO: 157; SEQ ID NO: 158), E742I (SEQ ID NO: 159; SEQ ID NO: 160), E742M (SEQ ID NO: 161; SEQ ID NO: 162), E742P (SEQ ID NO: 163; SEQ ID NO: 164), E742S (SEQ ID NO: 165; SEQ ID NO: 166), E39K/E189K (SEQ ID NO: 167; SEQ ID NO: 168), E39K/E230K (SEQ ID NO: 169; SEQ ID NO: 170), E39K/E520K (SEQ ID NO: 171; SEQ ID NO: 172), E39K/E537K (SEQ ID NO: 173; SEQ ID NO: 174), E39K/D578R (SEQ ID NO: 175; SEQ ID NO: 176), E39K/D732R (SEQ ID NO: 177; SEQ ID NO: 178), E39K/E742K (SEQ ID NO: 179; SEQ ID NO: 180), G46D/E189K (SEQ ID NO: 181; SEQ ID NO: 182), and G46D/E230K (SEQ ID NO: 183; SEQ ID NO: 184).

FIG. 4: shows a gel indicating the activity comparison of reverse transcriptase WT (SEQ ID NO: 1; SEQ ID NO: 2) and the following mutants: G46D/N384R (SEQ ID NO: 185; SEQ ID NO: 186), G46D/D578R (SEQ ID NO: 187; SEQ ID NO: 188), E189K/E230K (SEQ ID NO: 189; SEQ ID NO: 190), E189K/E520K (SEQ ID NO: 191; SEQ ID NO: 192), E189K/E537K (SEQ ID NO: 193; SEQ ID NO: 194), E189K/D578R (SEQ ID NO: 195; SEQ ID NO: 196), E189K/E742K (SEQ ID NO: 199; SEQ ID NO: 200), E230K/E520K (SEQ ID NO: 201; SEQ ID NO: 202), E230K/E537K (SEQ ID NO: 203; SEQ ID NO: 204), E230K/D578R (SEQ ID NO: 205; SEQ ID NO: 206), E230K/D732R (SEQ ID NO: 207; SEQ ID NO: 208), E230K/E742K (SEQ ID NO: 209; SEQ ID NO: 210), E537K/D578R (SEQ ID NO: 219; SEQ ID NO: 220), E537K/D732R (SEQ ID NO: 221; SEQ ID NO: 222), E537K/E742K (SEQ ID NO: 223; SEQ ID NO: 224), D732R/E742K (SEQ ID NO: 229; SEQ ID NO: 230), G46D/E189K/E230K (SEQ ID NO: 231; SEQ ID NO: 232), G46D/E189K/D578R (SEQ ID NO: 233; SEQ ID NO: 234), G46D/E189K/F667Y (SEQ ID NO: 235; SEQ ID NO: 236), G46D/E189K/D732R (SEQ ID NO: 237; SEQ ID NO: 238), G46D/E230K/F667Y (SEQ ID NO: 239; SEQ ID NO: 240), G46D/E230K/D732R (SEQ ID NO: 241; SEQ ID NO: 242), G46D/N384R/F667Y (SEQ ID NO: 243; SEQ ID NO: 244), G46D/D578R/F667Y (SEQ ID NO: 245; SEQ ID NO: 246), E189K/E230K/E520K (SEQ ID NO: 247; SEQ ID NO: 248), E189K/E230K/E537K (SEQ ID NO: 249; SEQ ID NO: 250), E189K/E230K/D578R (SEQ ID NO: 251; SEQ ID NO: 252), E189K/E230K/D732R (SEQ ID NO: 253; SEQ ID NO: 254), E189K/E230K/E742K (SEQ ID NO: 255; SEQ ID NO: 256), E189K/E520K/E537K (SEQ ID NO: 257; SEQ ID NO: 258), E189K/E520K/D578R (SEQ ID NO: 259; SEQ ID NO: 260), E189K/E520K/D732R (SEQ ID NO: 261; SEQ ID NO: 262), E189K/E520K/E742K (SEQ ID NO: 263; SEQ ID NO: 264), E189K/E537K/D578R (SEQ ID NO: 265; SEQ ID NO: 266), E189K/E537K/D732R (SEQ ID NO: 267; SEQ ID NO: 268), E189K/E537K/E742K (SEQ ID NO: 269; SEQ ID NO: 270), and E189K/D578R/D732R (SEQ ID NO: 271; SEQ ID NO: 272).

FIG. 5: shows a gel indicating the activity comparison of reverse transcriptase WT (SEQ ID NO: 1; SEQ ID NO: 2) and the following mutants: E189K/D578R/E742K (SEQ ID NO: 273; SEQ ID NO: 274), E189K/D732R/E742K (SEQ ID NO: 275; SEQ ID NO: 276), E230K/E520K/E537K (SEQ ID NO: 277; SEQ ID NO: 278), E230K/E520K/D578R (SEQ ID NO: 279; SEQ ID NO: 280), E230K/E520K/D732R (SEQ ID NO: 281; SEQ ID NO: 282), E230K/E520K/E742K (SEQ ID NO: 283; SEQ ID NO: 284), E230K/E537K/D578R (SEQ ID NO: 285; SEQ ID NO: 286), E520K/E537K/D578R (SEQ ID NO: 293; SEQ ID NO: 294), E230K/E537K/D732R (SEQ ID NO: 287; SEQ ID NO: 288), E230K/D732R/E742K (SEQ ID NO: 291; SEQ ID NO: 292), E520K/E537K/D578R (SEQ ID NO: 293; SEQ ID NO: 294), E520K/E537K/D732R (SEQ ID NO: 295; SEQ ID NO: 296), E520K/D578R/D732R (SEQ ID NO: 297; SEQ ID NO: 298), E537K/D578R/

Figure 1:
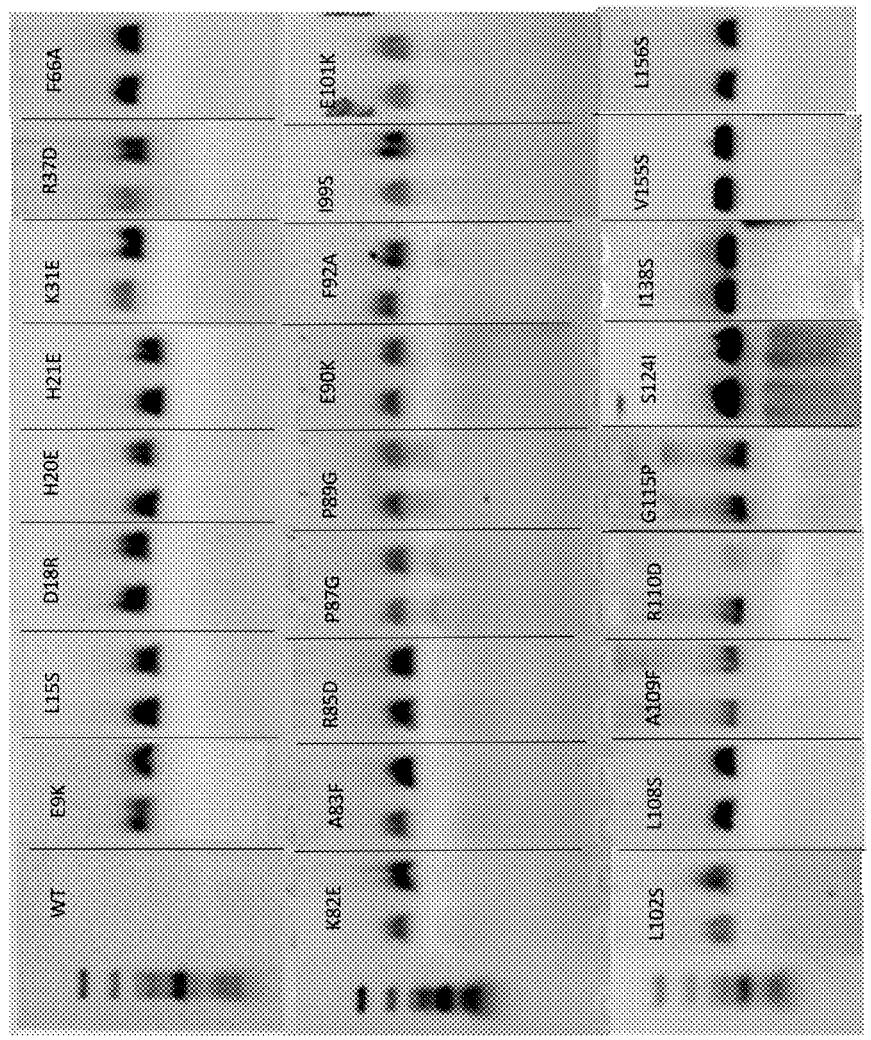
FIGS. 1 to 5 are gel images from cDNA amplification comparisons (thereby indicating the reverse transcriptase activity) of a Taq DNA wild type versus the mutants identified in each figure, and described in the figure summaries below. Each composite gel shows the WT and mutant activity, aligned against a low-molecular weight ladder (far left column of each figure). The mutants shown in each gel and their DNA sequences (odd numbered identifiers) and their protein sequences (even numbered identifiers) and are shown below.

D732R (SEQ ID NO: 301; SEQ ID NO: 302), E520K/ D732R/E742K (SEQ ID NO: 299; SEQ ID NO: 300), E537K/D578R/E742K (SEQ ID NO: 303; SEQ ID NO: 304), E537K/D578R/E742K (SEQ ID NO: 303; SEQ ID NO: 304), D578R/D732R/E742K (SEQ ID NO: 307; SEQ ID NO: 308), G46D/E189K/E230K/F667Y (SEQ ID NO: 309; SEQ ID NO: 310), and G46D/E189K/D578R/F667Y (SEQ ID NO: 311; SEQ ID NO: 312).

DETAILED DESCRIPTION

The term "biologically active fragment" refers to any fragment, derivative, homolog or analog of a Taq DNA polymerase or Variant Sequences that possesses in vivo or in vitro reverse transcriptase activity that is characteristic of that biomolecule. In some embodiments, the biologically active fragment, derivative, homolog or analog of the mutant Taq DNA polymerase possesses any degree of the biological activity of the mutant Taq DNA polymerase in any in vivo or in vitro assay.

In some embodiments, the biologically active fragment can optionally include any number of contiguous amino acid residues of the mutant Taq DNA polymerase or Variant Sequences. The invention also includes the polynucleotides encoding any such biologically active fragment and/or Degenerate Nucleic Acid Sequences.

Biologically active fragments can arise from post transcriptional processing or from translation of alternatively spliced RNAs, or alternatively can be created through engineering, bulk synthesis, or other suitable manipulation. Biologically active fragments include fragments expressed in native or endogenous cells as well as those made in expression systems such as, for example, in bacterial, yeast, plant, insect or mammalian cells.

As used herein, the phrase "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz (1979) Principles of Protein Structure, Springer-Verlag). According to such analyses, groups of amino acids can be defined where amino acids within a group exchange preferentially with each other, and therefore resemble each other most in their impact on the overall protein structure (Schulz (1979) supra). Examples of amino acid groups defined in this manner can include: a "charged/polar group" including Glu, Asp, Asn, Gln, Lys, Arg, and His; an "aromatic or cyclic group" including Pro, Phe, Tyr, and Trp; and an "aliphatic group" including Gly, Ala, Val, Leu, Ile, Met, Ser, Thr, and Cys. Within each group, subgroups can also be identified. For example, the group of charged/polar amino acids can be sub-divided into sub-groups including: the "positively-charged sub-group" comprising Lys, Arg and His; the "negatively-charged sub-group" comprising Glu and Asp; and the "polar sub-group" comprising Asn and Gln. In another example, the aromatic or cyclic group can be sub-divided into sub-groups including: the "nitrogen ring sub-group" comprising Pro, His, and Trp; and the "phenyl sub-group" comprising Phe and Tyr. In another further example, the aliphatic group can be sub-divided into sub-groups including: the "large aliphatic non-polar sub-group" comprising Val, Leu, and Ile; the "aliphatic slightly-polar sub-group" comprising Met, Ser, Thr, and Cys; and the "small-residue sub-group" comprising Gly and Ala. Examples of conservative mutations include amino acid substitutions of amino acids within the sub-groups above, such as, but not limited to: Lys for Arg or vice versa, such that a positive charge can be maintained; Glu for Asp or vice versa, such that a negative charge can be maintained; Ser for Thr or vice versa, such that a free —OH can be maintained; and Gln for Asn or vice versa, such that a free —NH2 can be maintained. A "conservative variant" is a polypeptide that includes one or more amino acids that have been substituted to replace one or more amino acids of the reference polypeptide (for example, a polypeptide whose sequence is disclosed in a publication or sequence database, or whose sequence has been determined by nucleic acid sequencing) with an amino acid having common properties, e.g., belonging to the same amino acid group or sub-group as delineated above.

When referring to a gene, "mutant" means the gene has at least one base (nucleotide) change, deletion, or insertion with respect to a native or wild type gene. The mutation (change, deletion, and/or insertion of one or more nucleotides) can be in the coding region of the gene or can be in an intron, 3' UTR, 5' UTR, or promoter region. As nonlimiting examples, a mutant gene can be a gene that has an insertion within the promoter region that can either increase or decrease expression of the gene; can be a gene that has a deletion, resulting in production of a nonfunctional protein, truncated protein, dominant negative protein, or no protein; or, can be a gene that has one or more point mutations leading to a change in the amino acid of the encoded protein or results in aberrant splicing of the gene transcript.

The terms "mutant Taq DNA polymerase of the invention" and "mutant Taq DNA polymerase" when used in this Detailed Description section refer to, depending on the context, collectively or individually, the mutant Taq DNA polymerase polypeptides tested and exhibiting enhanced reverse transcriptase activity which are shown below in Table I (and above in the figure descriptions), where for each mutant in Table I, the following odd numbered sequence identifier is the DNA sequence and the following even numbered sequence identifier is the protein sequence, but not including the tag sequence: GSGSSGHHHHHH (SEQ ID NO:315) added at the C-Terminus or the DNA encoding it. The terms "mutant Taq DNA polymerase of the invention" and "mutant Taq DNA polymerase" also includes Variant Sequences and/or Degenerate Nucleic Acid Sequences, as those terms are defined in the Summary section.

TABLE I

E9K (SEQ ID NO: 3; SEQ ID NO: 4), L15S (SEQ ID NO: 5; SEQ ID NO: 6), D18R (SEQ ID NO: 7; SEQ ID NO: 8), H20E (SEQ ID NO: 9; SEQ ID NO: 10), H21E (SEQ ID NO: 11; SEQ ID NO: 12), K31E (SEQ ID NO: 13; SEQ ID NO: 14), R37D (SEQ ID NO: 15; SEQ ID NO: 16), F66A (SEQ ID NO: 17; SEQ ID NO: 18), K82E (SEQ ID NO: 19; SEQ ID NO: 20), A83F (SEQ ID NO: 21; SEQ ID NO: 22), R85D (SEQ ID NO: 23; SEQ ID NO: 24), P87G (SEQ ID NO: 25; SEQ ID NO: 26), P89G (SEQ ID NO: 27; SEQ ID NO: 28), E90K (SEQ ID NO: 29; SEQ ID NO: 30), F92A (SEQ ID NO: 31; SEQ ID NO: 32), I99S (SEQ ID NO: 33; SEQ ID NO: 34), E101K (SEQ ID NO: 35; SEQ ID NO: 36), L102S (SEQ ID NO: 37; SEQ ID NO: 38), L108S (SEQ ID NO: 39; SEQ ID NO: 40), A109F (SEQ ID NO: 41; SEQ ID NO: 42), R110D

TABLE I-continued (SEQ ID NO: 43; SEQ ID NO: 44), G115P (SEQ ID NO: 45; SEQ ID NO: 46), S124I (SEQ ID NO: 47; SEQ ID NO: 48), I138S (SEQ ID NO: 49; SEQ ID NO: 50), V155S (SEQ ID NO: 51; SEQ ID NO: 52), L156S (SEQ ID NO: 53; SEQ ID NO: 54), H157E (SEQ ID NO: 55; SEQ ID NO: 56), T164I (SEQ ID NO: 57; SEQ ID NO: 58), L168S (SEQ ID NO: 59; SEQ ID NO: 60), R183D (SEQ ID NO: 61; SEQ ID NO: 62), G187P (SEQ ID NO: 63; SEQ ID NO: 64), E189A (SEQ ID NO: 65; SEQ ID NO: 66), E189I (SEQ ID NO: 67; SEQ ID NO: 68), E189K (SEQ ID NO: 69; SEQ ID NO: 70), E189S (SEQ ID NO: 71; SEQ ID NO: 72), K202E (SEQ ID NO: 73; SEQ ID NO: 74), E230A (SEQ ID NO: 75; SEQ ID NO: 76), E230C (SEQ ID NO: 77; SEQ ID NO: 78), E230M (SEQ ID NO: 79; SEQ ID NO: 80), E230Q (SEQ ID NO: 81; SEQ ID NO: 82), E230V (SEQ ID NO: 83; SEQ ID NO: 84), L233S (SEQ ID NO: 85; SEQ ID NO: 86), H235E (SEQ ID NO: 87; SEQ ID NO: 88), M236S (SEQ ID NO: 89; SEQ ID NO: 90), D237R (SEQ ID NO: 91; SEQ ID NO: 92), D244R (SEQ ID NO: 93; SEQ ID NO: 94), K247E (SEQ ID NO: 95; SEQ ID NO: 96), L281S (SEQ ID NO: 97; SEQ ID NO: 98), P291G (SEQ ID NO: 99; SEQ ID NO: 100), L294S (SEQ ID NO: 101; SEQ ID NO: 102), V310S (SEQ ID NO: 103; SEQ ID NO: 104), K314E (SEQ ID NO: 105; SEQ ID NO: 106), R349D (SEQ ID NO: 107; SEQ ID NO: 108), L379S (SEQ ID NO: 109; SEQ ID NO: 110), S383I (SEQ ID NO: 111; SEQ ID NO: 112), Y394A (SEQ ID NO: 113; SEQ ID NO: 114), G395P (SEQ ID NO: 115; SEQ ID NO: 116), A442F (SEQ ID NO: 117; SEQ ID NO: 118), E507G (SEQ ID NO: 119; SEQ ID NO: 120), E507I (SEQ ID NO: 121; SEQ ID NO: 122), E507L (SEQ ID NO: 123; SEQ ID NO: 124), E537W (SEQ ID NO: 125; SEQ ID NO: 126), T544I (SEQ ID NO: 127; SEQ ID NO: 128), P550G (SEQ ID NO: 129; SEQ ID NO: 130), D578F (SEQ ID NO: 131; SEQ ID NO: 132), D578R (SEQ ID NO: 133; SEQ ID NO: 134), D578T (SEQ ID NO: 135; SEQ ID NO: 136), D578Y (SEQ ID NO: 137; SEQ ID NO: 138), D732A (SEQ ID NO: 139; SEQ ID NO: 140), D732F (SEQ ID NO: 141; SEQ ID NO: 142), D732G (SEQ ID NO: 143; SEQ ID NO: 144), D732I (SEQ ID NO: 145; SEQ ID NO: 146), D732P (SEQ ID NO: 147; SEQ ID NO: 148), D732Q (SEQ ID NO: 149; SEQ ID NO: 150), D732S (SEQ ID NO: 151; SEQ ID NO: 152), E742A (SEQ ID NO: 153; SEQ ID NO: 154), E742G (SEQ ID NO: 155; SEQ ID NO: 156), E742H (SEQ ID NO: 157; SEQ ID NO: 158), E742I (SEQ ID NO: 159; SEQ ID NO: 160), E742M (SEQ ID NO: 161; SEQ ID NO: 162), E742P (SEQ ID NO: 163; SEQ ID NO: 164), E742S (SEQ ID NO: 165; SEQ ID NO: 166), E39/E189K (SEQ ID NO: 167; SEQ ID NO: 168), E39K/E230K (SEQ ID NO: 169; SEQ ID NO: 170), E39K/E520K (SEQ ID NO: 171; SEQ ID NO: 172), E39K/E537K (SEQ ID NO: 173; SEQ ID NO: 174), E39K/D578R (SEQ ID NO: 175; SEQ ID NO: 176), E39K/D732R (SEQ ID NO: 177; SEQ ID NO: 178), E39K/E742K (SEQ ID NO: 179; SEQ ID NO: 180), G46D/E189K (SEQ ID NO: 181; SEQ ID NO: 182), G46D/E230K (SEQ ID NO: 183; SEQ ID NO: 184), G46D/N384R (SEQ ID NO: 185; SEQ ID NO: 186), G46D/D578R (SEQ ID NO: 187; SEQ ID NO: 188), E189K/E230K (SEQ ID NO: 189; SEQ ID NO: 190), E189K/E520K (SEQ ID NO: 191; SEQ ID NO: 192), E189K/E537K (SEQ ID NO: 193; SEQ ID NO: 194), E189K/D578R (SEQ ID NO: 195; SEQ ID NO: 196), E189K/D732R (SEQ ID NO: 197; SEQ ID NO: 198), E189K/E742K (SEQ ID NO: 199; SEQ ID NO: 200), E230K/E520K (SEQ ID NO: 201; SEQ ID NO: 202), E230K/E537K (SEQ ID NO: 203; SEQ ID NO: 204), E230K/D578R (SEQ ID NO: 205; SEQ ID NO: 206), E230K/D732R (SEQ ID NO: 207; SEQ ID NO: 208), E230K/E742K (SEQ ID NO: 209; SEQ ID NO: 210), E520K/E537K (SEQ ID NO: 211; SEQ ID NO: 212), E520K/D578R (SEQ ID NO: 213; SEQ ID NO: 214), E520K/D732R (SEQ ID NO: 215; SEQ ID NO: 216), E520K/E742K (SEQ ID NO: 217; SEQ ID NO: 218), E537K/D578R (SEQ ID NO: 219; SEQ ID NO: 220), E537K/D732R (SEQ ID NO: 221; SEQ ID NO: 222), E537K/E742K (SEQ ID NO: 223; SEQ ID NO: 224), D578R/D732R (SEQ ID NO: 225; SEQ ID NO: 226), D578R/E742K (SEQ ID NO: 227; SEQ ID NO: 228), D732R/E742K (SEQ ID NO: 229; SEQ ID NO: 230), G46D/E189K/E230K (SEQ ID NO: 231; SEQ ID NO: 232), G46D/E189K/D578R (SEQ ID NO: 233; SEQ ID NO: 234), G46D/E189K/F667Y (SEQ ID NO: 235; SEQ ID NO: 236), G46D/E189K/D732R (SEQ ID NO: 237; SEQ ID NO: 238), G46D/E230K/F667Y (SEQ ID NO: 239; SEQ ID NO: 240), G46D/E230K/D732R (SEQ ID NO: 241; SEQ ID NO: 242), G46D/N384R/F667Y (SEQ ID NO: 243; SEQ ID NO: 244), G46D/D578R/F667Y (SEQ ID NO: 245; SEQ ID NO: 246), E189K/E230K/E520K (SEQ ID NO: 247; SEQ ID NO: 248), E189K/E230K/E537K (SEQ ID NO: 249; SEQ ID NO: 250), E189K/E230K/D578R (SEQ ID NO: 251; SEQ ID NO: 252), E189K/E230K/D732R (SEQ ID NO: 253; SEQ ID NO: 254), E189K/E230K/E742K (SEQ ID NO: 255; SEQ ID NO: 256), E189K/E520K/E537K (SEQ ID NO: 257; SEQ ID NO: 258), E189K/E520K/D578R (SEQ ID NO: 259; SEQ ID NO: 260), E189K/E520K/D732R (SEQ ID NO: 261; SEQ ID NO: 262), E189K/E520K/E742K (SEQ ID NO: 263; SEQ ID NO: 264), E189K/E537K/D578R (SEQ ID NO: 265; SEQ ID NO: 266), E189K/E537K/D732R (SEQ ID NO: 267; SEQ ID NO: 268), E189K/E537K/E742K (SEQ ID NO: 269; SEQ ID NO: 270), E189K/D578R/D732R (SEQ ID NO: 271; SEQ ID NO: 272), E189K/D578R/E742K (SEQ ID NO: 273; SEQ ID NO: 274), E189K/D732R/E742K (SEQ ID NO: 275; SEQ ID NO: 276), E230K/E520K/E537K (SEQ ID NO: 277; SEQ ID NO: 278), E230K/E520K/D578R (SEQ ID NO: 279; SEQ ID NO: 280), E230K/E520K/D732R (SEQ ID NO: 281; SEQ ID NO: 282), E230K/E520K/E742K (SEQ ID NO: 283; SEQ ID NO: 284), E230K/E537K/D578R (SEQ ID NO: 285; SEQ ID NO: 286), E230K/E537K/D732R (SEQ ID NO: 287; SEQ ID NO: 288), E230K/D578R/D732R (SEQ ID NO: 289; SEQ ID NO: 290), E230K/D578R/D732R (SEQ ID NO: 289; SEQ ID NO: 290), E230K/D732R/E742K (SEQ ID NO: 291; SEQ ID NO: 292) E230K/D732R/E742K (SEQ ID NO: 291; SEQ ID NO: 292), E520K/E537K/D578R (SEQ ID NO: 293; SEQ ID NO: 294), E520K/E537K/D732R (SEQ ID NO: 295; SEQ ID NO: 296), E520K/D578R/D732R (SEQ ID NO: 297; SEQ ID NO: 298), E520K/D732R/E742K (SEQ ID NO: 299; SEQ ID NO: 300), E537K/D578R/D732R (SEQ ID NO: 301; SEQ ID NO: 302), E537K/D578R/E742K (SEQ ID NO: 303; SEQ ID NO: 304), E537K/D732R/E742K (SEQ ID NO: 305; SEQ ID NO: 306), D578R/D732R/E742K (SEQ ID NO: 307; SEQ ID NO: 308), G46D/E189K/E230K/F667Y (SEQ ID NO: 309; SEQ ID NO: 310), and G46D/E189K/D578R/F667Y (SEQ ID NO: 311; SEQ ID NO: 312).

"Naturally-occurring" or "wild-type" refers to the form found in nature. For example, a naturally occurring or wild-type polypeptide or polynucleotide sequence is a sequence present in an organism, which has not been intentionally modified by human manipulation.

The terms "percent identity" or "homology" with respect to nucleic acid or polypeptide sequences are defined as the percentage of nucleotide or amino acid residues in the candidate sequence that are identical with the known polypeptides, after aligning the sequences for maximum percent identity and introducing gaps, if necessary, to achieve the maximum percent homology. N-terminal or C-terminal insertion or deletions shall not be construed as affecting homology. Homology or identity at the nucleotide or amino acid sequence level can be determined by BLAST (Basic Local Alignment Search Tool) analysis using the algorithm employed by the programs blastp, blastn, blastx, tblastn, and tblastx (Altschul (1997), Nucleic Acids Res. 25, 3389-3402, and Karlin (1990), Proc. Natl. Acad. Sci. USA 87, 2264-2268), which are tailored for sequence similarity searching. The approach used by the BLAST program is to first consider similar segments, with and without gaps, between a query sequence and a database sequence, then to evaluate the statistical significance of all matches that are identified, and finally to summarize only those matches which satisfy a preselected threshold of significance. For a discussion of basic issues in similarity searching of sequence databases, see Altschul (1994), Nature Genetics 6, 119-129. The search parameters for histogram, descriptions, alignments, expect (i.e., the statistical significance threshold for reporting matches against database sequences), cutoff, matrix, and filter (low complexity) can be at the default settings. The default scoring matrix used by blastp, blastx, tblastn, and tblastx is the BLOSUM62 matrix (Henikoff (1992), Proc. Natl. Acad. Sci. USA 89, 10915-10919), recommended for query sequences over 85 units in length (nucleotide bases or amino acids).

In some embodiments, the invention relates to methods (and related kits, systems, apparatuses and compositions) for performing a ligation reaction comprising or consisting of contacting a mutant Taq DNA polymerase or a biologically active fragment thereof with a nucleic acid template in the presence of one or more nucleotides, and ligating at least one of the one or more nucleotides using the mutant Taq DNA polymerase or the biologically active fragment thereof.

In some embodiments, the method can include ligating a double stranded RNA or DNA polynucleotide strand into a circular molecule. In some embodiments, the method can further include detecting a signal indicating the ligation by using a sensor. In some embodiments, the sensor is an ISFET. In some embodiments, the sensor can include a detectable label or detectable reagent within the ligating reaction.

Making Mutant Taq DNA Polymerase

The mutant Taq DNA polymerase of the invention can be expressed in any suitable host system, including a bacterial, yeast, fungal, baculovirus, plant or mammalian host cell. For bacterial host cells, suitable promoters for directing transcription of the nucleic acid constructs of the present disclosure, include the promoters obtained from the *E. coli* lac operon, *Streptomyces coelicolor agarase* gene (dagA), *Bacillus subtilis levansucrase* gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis penicillinase* gene (penP), *Bacillus subtilis* xylA and xylB genes, and prokaryotic beta-lactamase gene (Villa-Kamaroff et al., 1978, Proc. Natl Acad. Sci. USA 75:3727-3731), as well as the tac promoter (DeBoer et al., 1983, Proc. Natl Acad. Sci. USA 80:21-25).

For filamentous fungal host cells, suitable promoters for directing the transcription of the nucleic acid constructs of the present disclosure include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof.

In a yeast host, useful promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, Yeast 8:423-488.

For baculovirus expression, insect cell lines derived from Lepidopterans (moths and butterflies), such as Spodoptera frugiperda, are used as host. Gene expression is under the control of a strong promoter, e.g., pPolh.

Plant expression vectors are based on the Ti plasmid of Agrobacterium tumefaciens, or on the tobacco mosaic virus (TMV), potato virus X, or the cowpea mosaic virus. A commonly used constitutive promoter in plant expression vectors is the cauliflower mosaic virus (CaMV) 35S promoter.

For mammalian expression, cultured mammalian cell lines such as the Chinese hamster ovary (CHO), COS, including human cell lines such as HEK and HeLa may be used to produce the mutant Taq DNA polymerase. Examples of mammalian expression vectors include the adenoviral vectors, the pSV and the pCMV series of plasmid vectors, vaccinia and retroviral vectors, as well as baculovirus. The promoters for cytomegalovirus (CMV) and SV40 are commonly used in mammalian expression vectors to drive gene expression. Non-viral promoters, such as the elongation factor (EF)-1 promoter, are also known.

The control sequence for the expression may also be a suitable transcription terminator sequence, that is, a sequence recognized by a host cell to terminate transcription. The terminator sequence is operably linked to the 3' terminus of the nucleic acid sequence encoding the polypeptide. Any terminator which is functional in the host cell of choice may be used.

For example, exemplary transcription terminators for filamentous fungal host cells can be obtained from the genes for *Aspergillus oryzae* TAKA amylase, *Aspergillus niger* glucoamylase, *Aspergillus nidulans anthranilate* synthase, *Aspergillus niger* alpha-glucosidase, and *Fusarium oxysporum* trypsin-like protease.

Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase.

Terminators for insect, plant and mammalian host cells are also well known.

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used.

Effective signal peptide coding regions for bacterial host cells are the signal peptide coding regions obtained from the genes for Bacillus NCIB 11837 maltogenic 1 amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, Microbiol Rev 57:109-137.

Effective signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells can be from the genes for *Saccharomyces cerevisiae* alpha-factor and *Saccharomyces cerevisiae* invertase. Signal peptides for other host cell systems are also well known.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the mutant Taq DNA polymerase relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter. Regulatory systems for other host cells are also well known.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the polypeptide of the present invention would be operably linked with the regulatory sequence.

Another embodiment includes a recombinant expression vector comprising a polynucleotide encoding an engineered mutant Taq DNA polymerase or a variant thereof, and one or more expression regulating regions such as a promoter and a terminator, and a replication origin, depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the mutant Taq DNA polymerase at such sites. Alternatively, the nucleic acid sequences of the mutant Taq DNA polymerase may be expressed by inserting the nucleic acid sequences or a nucleic acid construct comprising the sequences into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the mutant Taq DNA polymerase polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector herein preferably contain one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*. Selectable markers for insect, plant and mammalian cells are also well known.

The expression vectors of the present invention preferably contain an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or nonhomologous recombination.

Alternatively, the expression vector may contain additional nucleic acid sequences for directing integration by homologous recombination into the genome of the host cell. The additional nucleic acid sequences enable the vector to be integrated into the host cell genome at a precise location (s) in the chromosome(s). The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori, or the origins of replication of plasmids pBR322, pUC19, pACYC177 (which plasmid has the P15A ori), or pACYC184 permitting replication in *E. coli*, and pUB110, pE194, pTA1060, or pAM31 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (see, e.g., Ehrlich, 1978, Proc Natl Acad Sci. USA 75:1433).

More than one copy of a nucleic acid sequence of the mutant Taq DNA polymerase may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Expression vectors for the mutant Taq DNA polymerase polynucleotide are commercially available. Suitable commercial expression vectors include p3×FLAG™ expression vectors from Sigma-Aldrich Chemicals, St. Louis Mo., which includes a CMV promoter and hGH polyadenylation site for expression in mammalian host cells and a pBR322 origin of replication and ampicillin resistance markers for amplification in *E. coli*. Other suitable expression vectors are pBluescriptII SK(-) and pBK-CMV, which are commercially available from Stratagene, LaJolla Calif., and plasmids which are derived from pBR322 (Gibco BRL), pUC (Gibco BRL), pREP4, pCEP4 (Invitrogen) or pPoly (Lathe et al., 1987, Gene 57:193-201).

Suitable host cells for expression of a polynucleotide encoding the mutant Taq DNA polymerase, are well known in the art and include but are not limited to, bacterial cells, such as *E. coli, Lactobacillus kefir, Lactobacillus brevis, Lactobacillus minor, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and Spodoptera Sf9 cells; animal cells such as CHO, COS, BHK, 293, and Bowes melanoma cells; and plant cells. Appropriate culture mediums and growth conditions for the above-described host cells are well known in the art.

Polynucleotides for expression of the mutant Taq DNA polymerase may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to the skilled artisan.

Polynucleotides encoding the mutant Taq DNA polymerase can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides can be prepared by chemical synthesis using, e.g., the classical phosphoramidite method described by Beaucage et al., 1981, Tet Lett 22:1859-69, or the method described by Matthes et al., 1984, EMBO J. 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources, such as The Midland Certified Reagent Company, Midland, Tex., The Great American Gene Company, Ramona, Calif., Express-Gen Inc. Chicago, Ill., and Operon Technologies Inc., Alameda, Calif.

Engineered the mutant Taq DNA polymerase expressed in a host cell can be recovered from the cells and or the culture medium using any one or more of the well-known techniques for protein purification, including, among others, lysozyme treatment, sonication, filtration, salting-out, ultracentrifugation, and chromatography. Suitable solutions for lysing and the high efficiency extraction of proteins from bacteria, such as *E. coli*, are commercially available under the trade name CelLytic B™ from Sigma-Aldrich of St. Louis Mo.

Chromatographic techniques for isolation of the mutant Taq DNA polymerase include, among others, reverse phase chromatography high performance liquid chromatography, ion exchange chromatography, gel electrophoresis, and affinity chromatography. Conditions for purification will depend, in part, on factors such as net charge, hydrophobicity, hydrophilicity, molecular weight, molecular shape, and will be apparent to those having skill in the art.

In some embodiments, affinity techniques may be used to isolate the mutant Taq DNA polymerase. For affinity chromatography purification, any antibody which specifically binds the mutant Taq DNA polymerase may be used. For the production of antibodies, various host animals, including but not limited to rabbits, mice, rats, etc., may be immunized by injection with a compound. The compound may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacilli Calmette Guerin) and Corynebacterium parvum.

Example of Making Mutant Taq DNA Polymerase

Taq DNA polymerase mutants exhibiting greater reverse transcriptase activity compared to wild type polymerase were engineered, characterized, and selected via polymerase chain reactions visualized via electrophoresis on agarose gels. Initial screening was followed up with probe-based qualitative, real-time PCR (qPCR) with a typical reverse transcription cycling protocol to detect specified ribonucleic acid (RNA) target sequences.

Taq DNA polymerase mutants were generated by conventional inverse PCR mutagenesis. All mutants are sequenced verified, expressed in *E. Coli*, and purified. All Taq DNA polymerase mutants and the wild type have an added C-terminal tag (SEQ ID NO:315) for ease of purification.

PCR was performed under the following conditions, where the target is the 28s gene.

```
Forward Primer:
                                    (SEQ ID NO: 313)
CCGCTGCGGTGAGCCTTGAA Reverse Primer:
                                    (SEQ ID NO: 314)
TCTCCGGGATCGGTCGCGTT
```

Target: 28s RNA, 10 ng from Total RNA—Human Tumor Cell Line: Hela (Biochain Catalog #R1255811-50).

Each 10 µl reaction contains 1.5 µl of 50 ng/µl Taq DNA polymerase, 0.4 µl of 10 nM Forward primer, 0.4 µl of 10 nM reverse primer, 1 µl of 10 copies/µl of target RNA, 0.4 µl 10 nM equimolar dNTPs, 0.1 µl 1M DDT, and 1 µl of 10× reaction buffer (which makes final of composition of 20 mM Tris-HCl, 80 mM Tris-Acetate, 10 mM $(NH_4)_2SO_4$, 10 mM KCl, 2 mM $MgSO_4$, 3 mM Mg-Acetate, 0.1% Triton®-X-100, pH 8.8@25° C., with water comprising the remaining 10 µl.

The thermal cycler used for this PCR assay was the Bio-Rad T100. The reaction protocol is as follows: 60° C. incubation for 20 minutes, 95° C. denature for 5 minutes, followed by 35 cycles of [95° C. 10 sec denaturing, 60° C. 30 sec extension], followed by 5 min incubation at 75° C. To each sample, 3 µl of 6× stop dye containing 6× GelRed nucleic acid stain (Biotium catalog #41003) was added. Samples were loaded, 10 µl each, into 2% agarose gels and compared to WT Taq polymerase and to Low Molecular Weight DNA Ladder (New England Biolabs, catalog #N3233).

Figure 2:
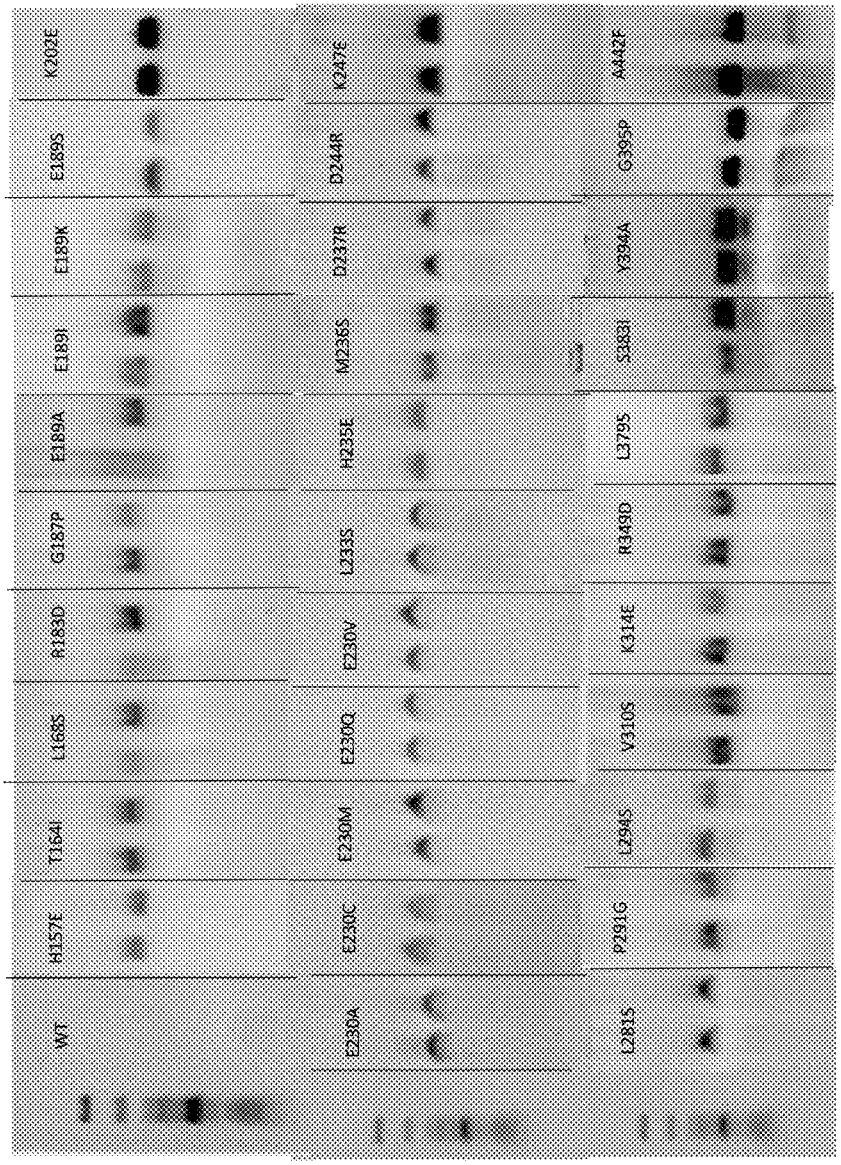
Figure 3:
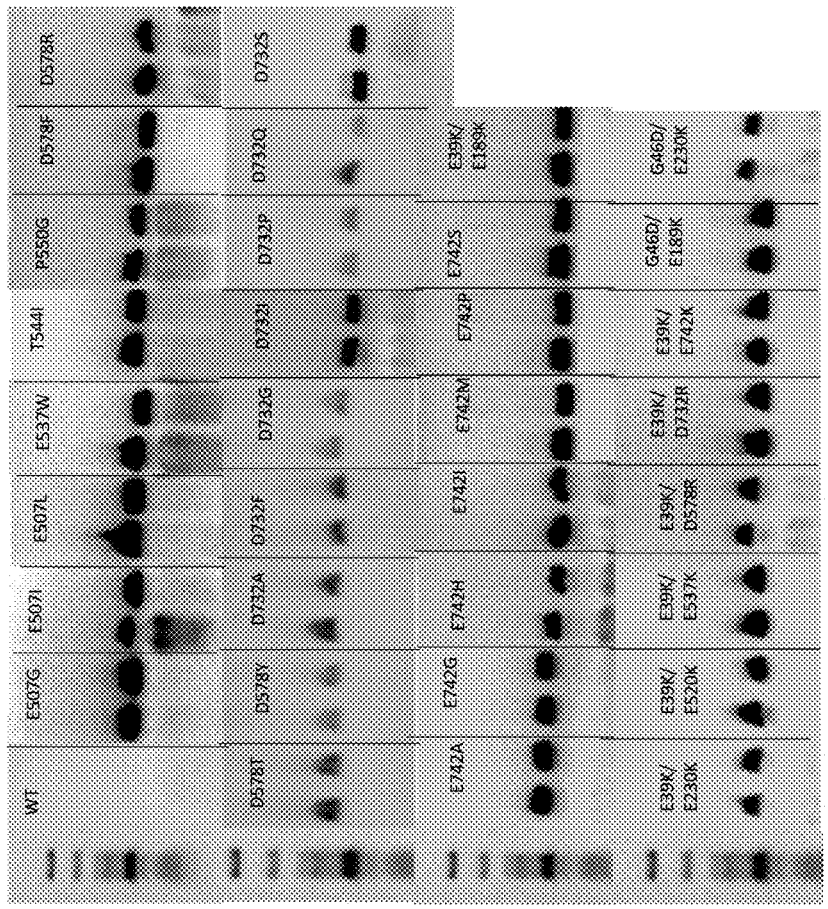
Figure 4:
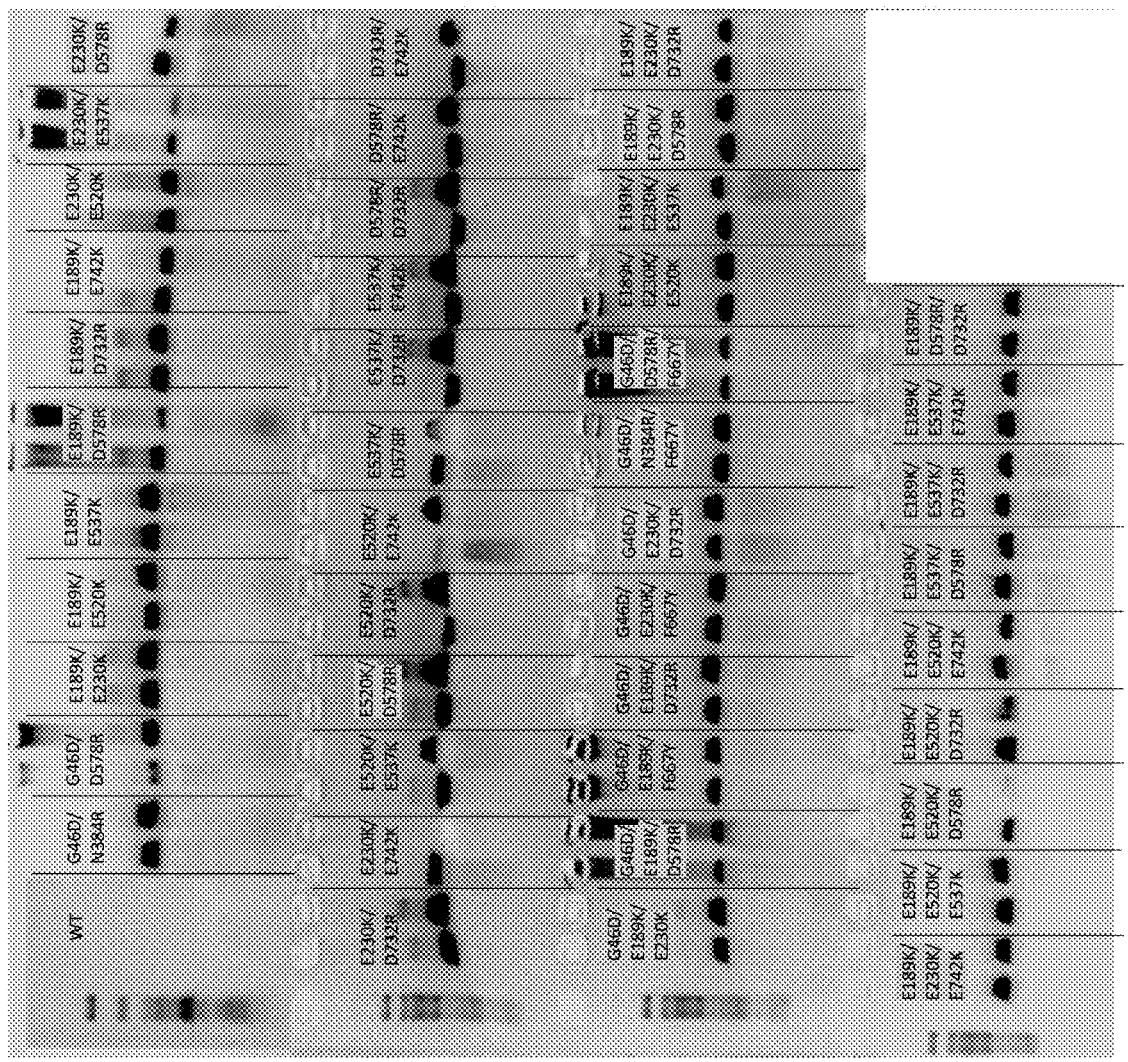
Figure 5:
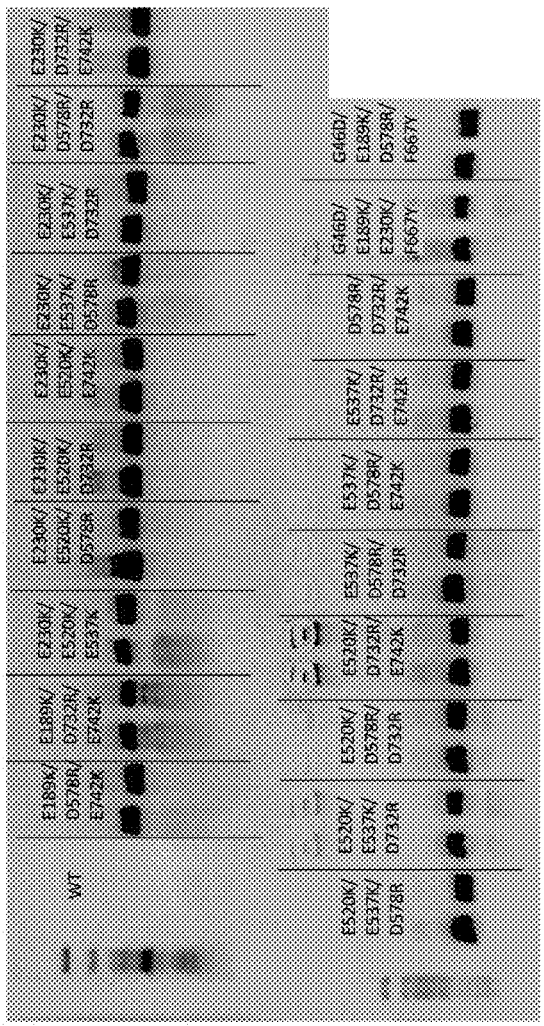

Results are shown in FIGS. 1 to 5. The wild-type result (WT) (SEQ ID NO: 2) is also shown in each figure, though it does not display any significant amplification.

qPCR Use of the Mutant Taq DNA Polymerases

The mutant Taq DNA polymerases in FIGS. 1 to 5 could be used to quantitate RNA in a sample using a conventional qPCR protocol for RNA detection, and without the need for additional reverse transcriptase in the reaction mixture. With qualitative, real-time PCR (qPCR), fluorescent signal generated through dyes (e.g., intercalating dyes such as SYBR Green or EvaGreen) or probes allows for data collection during PCR cycling so that target amplification can be measured and recorded. Probe-based chemistries utilize fluorescently labeled, target-specific probes which only release a reporter dye when bound to target sequence, allowing for real-time detection of target amplification as fluorescent signal intensity increases. Standard qPCR reaction mixtures include a reaction buffer (typically, similar to 20 mM Tris-HCl, 80 mM Tris-Acetate, 10 mM (NH4)2SO4, 10 mM KCl, 2 mM MgSO4, 3 mM Mg-Acetate, 0.1% Triton®-X-100, pH 8.8 @ 25° C.) with water comprising a remainder. A qPCR machine is preferably used for the reaction, e.g., the Prime Pro 48 Real-time qPCR machine (Cole-Parmer, UK). The reaction protocol including the cycle number, denaturation and annealing times and temperatures, are well established. A fluorescent signal is generated which can be measured. See US Publ'n No. 20220106576 (incorporated by reference).

The wild type sequences and the sequences of the mutants which showed enhanced reverse transcription activity are shown below, each with the sequence of the added tag sequence (SEQ ID NO: 315) at its C-terminus.

The specific methods and compositions described herein are representative of preferred embodiments and are exemplary and not intended as limitations on the scope of the invention.

Other objects, aspects, and embodiments will occur to those skilled in the art upon consideration of this specification, and are encompassed within the spirit of the invention as defined by the scope of the claims. It will be readily apparent to one skilled in the art that varying substitutions and modifications may be made to the invention disclosed herein without departing from the scope and spirit of the invention. The invention illustratively described herein suitably may be practiced in the absence of any element or elements, or limitation or limitations, which is not specifically disclosed herein as essential. Thus, for example, in each instance herein, in embodiments or examples of the present invention, any of the terms "comprising", "including", containing", etc. are to be read expansively and without limitation. The methods and processes illustratively described herein suitably may be practiced in differing orders of steps, and that they are not necessarily restricted to the orders of steps indicated herein or in the claims. It is also noted that as used herein and in the appended claims, the singular forms "a," "an," and "the" include plural reference, and the plural include singular forms, unless the context clearly dictates otherwise. Under no circumstances may the patent be interpreted to be limited to the specific examples or embodiments or methods specifically disclosed herein. Under no circumstances may the patent be interpreted to be limited by any statement made by any Examiner or any other official or employee of the Patent and Trademark Office unless such statement is specifically and without qualification or reservation expressly adopted in a responsive writing by Applicants.

The invention has been described broadly and generically herein. Each of the narrower species and subgeneric groupings falling within the generic disclosure also form part of the invention. The terms and expressions that have been employed are used as terms of description and not of limitation, and there is no intent in the use of such terms and expressions to exclude any equivalent of the features shown and described or portions thereof, but it is recognized that various modifications are possible within the scope of the invention as claimed. Thus, it will be understood that although the present invention has been specifically disclosed by preferred embodiments and optional features, modification and variation of the concepts herein disclosed may be resorted to by those skilled in the art, including but not limited to Variant Sequences, and that such modifications and variations are considered to be within the scope of this invention as defined by the appended claims.

Additional References

1. Kranaster R, Drum M, Engel N, Weidmann M, Hufert F T, Marx A. One-step RNA pathogen detection with reverse transcriptase activity of a mutated thermostable Thermus aquaticus DNA polymerase. Biotechnol J. 2010 February; 5(2):224-31. doi: 10.1002/biot.200900200. PMID: 20108275.
2. Bhadra S, Maranhao A C, Paik I, Ellington AD. One-Enzyme Reverse Transcription qPCR Using Taq DNA Polymerase. Biochemistry. 2020 Dec. 15; 59(49):4638-4645. doi: 10.1021/acs.biochem.0c00778. Epub 2020 Dec. 4. PMID: 33275410; PMCID: PMC7757722.
3. Barnes W M, Zhang Z, Kermekchiev M B. A Single Amino Acid Change to Taq DNA Polymerase Enables Faster PCR, Reverse Transcription and Strand-Displacement. Front Bioeng Biotechnol. 2021 Jan. 14; 8:553474. doi: 10.3389/fbioe.2020.553474. PMID: 33520948; PMCID: PMC7841393.

SEQUENCE LISTING (315 sequences)

SEQ ID NO: 1 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 2 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 3 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttaaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 4 - protein, 844 aa, synthetic construct
  REGION 1..844: note = Description of Artificial Sequence: Synthetic polypeptide
MRGMLPLFKPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 5 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgtctctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 6 - protein, 844 aa, synthetic construct
  REGION 1..844: note = Description of Artificial Sequence: Synthetic polypeptide
MRGMLPLFEPKGRVSLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 7 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttcgtggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 8 - protein, 844 aa, synthetic construct
  REGION 1..844: note = Description of Artificial Sequence: Synthetic polypeptide
MRGMLPLFEPKGRVLLVRGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 9 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtgaacacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 10 - protein, 844 aa, synthetic construct
  REGION 1..844: note = Description of Artificial Sequence: Synthetic polypeptide
MRGMLPLFEPKGRVLLVDGEHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 11 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatgaattagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 12 - protein, 844 aa, synthetic construct
  REGION 1..844: note = Description of Artificial Sequence: Synthetic polypeptide
MRGMLPLFEPKGRVLLVDGHELAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 13 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctggaagggctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 14 - protein, 844 aa, synthetic construct
  REGION 1..844: note = Description of Artificial Sequence: Synthetic polypeptide
MRGMLPLFEPKGRVLLVDGHHLAYRTFHALEGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 15 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctgacggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 16 - protein, 844 aa, synthetic construct
  REGION 1..844: note = Description of Artificial Sequence: Synthetic polypeptide
MRGMLPLFEPKGRVLLVDGHHLAYRTFHALKGLTTSDGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 17 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtggctgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 18 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVSADAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 19 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacgaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 20 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYEAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 21 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaatttggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 22 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKFGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 23 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagctggtgacgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 24 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGDAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 25 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagctggtgacgccgggaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 26 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAGTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 27 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagctggtgacgccccgaccggggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 28 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTGEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 29 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccgaaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 30 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPKDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 31 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagatgcgccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 32 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDAPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 33 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttatctaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 34 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALSKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 35 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaaaaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 36 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKKLVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 37 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaatctgttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 38 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKESVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 39 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggctctgcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 40 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGSARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 41 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttatttcgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 42 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLFRLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 43 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcagatctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 44 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLADLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 45 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgccctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 46 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPPYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 47 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcaattgccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 48 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLAILAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 49 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgctctctgaccgccgataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 50 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRSLTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 51 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcattctttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 52 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHSLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 53 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgtctcatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 54 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVSHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 55 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttagaaccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 56 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLEPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 57 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattattccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 58 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLIIPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 59 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggtcttgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 60 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWSWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 61 - DNA, 2536 bp, synthetic construct
  misc_feature 1..2536: note = Description of Artificial Sequence: Synthetic polynucleotide
  source 1..2536: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatgattgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 62 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYDALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 63 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgacccctgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 64 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTPDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 65 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgcttcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 66 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDASDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 67 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacatttcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 68 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDISDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 69 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 70 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 71 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgactcttcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 72 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDSSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 73 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaagaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 74 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEETARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 75 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgcgaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 76 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRAKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 77 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgctgcaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 78 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRCKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 79 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcatgaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 80 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRMKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 81 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgccagaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 82 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRQKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 83 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgtgaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 84 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRVKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 85 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaatttctgcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 86 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKISAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 87 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttggccgaaatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 88 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAEMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 89 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttggcccattctgatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 90 - protein, 845 aa, synthetic construct
  REGION 1..845: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHESDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 91 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttggcccatatgcgtgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 92 - protein, 845 aa, synthetic construct
  REGION 1..845: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHEMRDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 93 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttggcgtctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 94 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWRLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 95 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccgaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 96 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAEVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 97 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactcctgcatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 98 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSSLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 99 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctgggaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 100 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESGKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 101 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcatctgaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 102 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKASEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 103 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgtctagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 104 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFSLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 105 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtagggaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 106 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSREEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 107 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcagacggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 108 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEADGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 109 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctattctctggacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 110 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYSLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 111 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgatcaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 112 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPINTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 113 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcccgtcgcgctggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 114 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRAGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 115 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcccgtcgctatcccggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 116 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRAPGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 117 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctgtttcacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 118 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLFHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 119 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccggcaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 120 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTGKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 121 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccattaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 122 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTIKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 123 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccttgaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 124 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTLKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 125 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgttggctgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 126 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRWLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 127 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctatttatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 128 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSIYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 129 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaggtgatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 130 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLGDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 131 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcttcccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 132 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSFPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 133 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 134 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 135 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcaccccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 136 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSTPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 137 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagctatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 138 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSYPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 139 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggcgctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 140 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPALEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 141 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgtttctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 142 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPFLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 143 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgggcctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 144 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPGLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 145 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgatcctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 146 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPILEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 147 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgccgctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 148 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPPLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 149 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcagctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 150 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPQLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 151 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgagcctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 152 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPSLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 153 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgcggccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 154 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRAAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 155 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtggcgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 156 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRGAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 157 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtcatgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 158 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRHAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 159 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtattgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 160 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRIAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 161 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtatggccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 162 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRMAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 163 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtccggccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 164 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRPAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 165 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgttctgccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 166 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRSAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 167 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 168 - protein, 844 aa, synthetic construct
  REGION 1..844: note = Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 169 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 170 - protein, 844 aa, synthetic construct
  REGION 1..844: note = Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 171 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 172 - protein, 844 aa, synthetic construct
  REGION 1..844: note = Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 173 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 174 - protein, 844 aa, synthetic construct
  REGION 1..844: note = Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 175 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 176 - protein, 844 aa, synthetic construct
  REGION 1..844: note = Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 177 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 178 - protein, 844 aa, synthetic construct
  REGION 1..844: note = Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 179 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcaaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 180 - protein, 844 aa, synthetic construct
  REGION 1..844: note = Description of Artificial Sequence: Synthetic polypeptide
MRGMLPLFEPKGRVLLVDGHHLAYRTFHALKGLTTSRGKPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 181 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 182 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 183 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 184 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 185 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtcgtaccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 186 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSRTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 187 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 188 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 189 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 190 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 191 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 192 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 193 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 194 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 195 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 196 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 197 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 198 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 199 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 200 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 201 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 202 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 203 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 204 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 205 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 206 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 207 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 208 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 209 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 210 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 211 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 212 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 213 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 214 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 215 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 216 - protein, 844 aa, synthetic construct; identical to SEQ ID NO: 214
  REGION 1..844: note = Description of Artificial Sequence: Synthetic polypeptide

SEQ ID NO: 217 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 218 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 219 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 220 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 221 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 222 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 223 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 224 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 225 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 226 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 227 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 228 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 229 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 230 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 231 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 232 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 233 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 234 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 235 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaatattggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 236 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINYGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 237 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggatttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 238 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 239 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattatggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 240 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINYGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 241 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 242 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 243 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtcgtaccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattatggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 244 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSRTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINYGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 245 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattatggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 246 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINYGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 247 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 248 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 249 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 250 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 251 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 252 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 253 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 254 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 255 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 256 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 257 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 258 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 259 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 260 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 261 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 262 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 263 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 264 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 265 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 266 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 267 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 268 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 269 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 270 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 271 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 272 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 273 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 274 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 275 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 276 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 277 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccaaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 278 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTKKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 279 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 280 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 281 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 282 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 283 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 284 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 285 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 286 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 287 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 288 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 289 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 290 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 291 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 292 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 293 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 294 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 295 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 296 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 297 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 298 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 299 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctgaaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 300 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLKALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 301 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 302 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 303 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 304 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 305 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtaaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 306 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRKLTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 307 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatggttttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacgaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattttggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccgcgtctggaagcgagagttaaatcagtgcgtaaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 308 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVRKAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 309 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcaaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagcgatccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattatggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 310 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIRKKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINYGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 311 - DNA, 2535 bp, synthetic construct
  misc_feature 1..2535: note = Description of Artificial Sequence: Synthetic polynucleotide
  source 1..2535: mol_type = other DNA
atgcgcggtatgctgccgttatttgaaccgaaaggtcgtgtgctgctggttgatggtcatcacttagcatatcgtacctttcatgccctgaaaggcctgaccacctctcgcggcgaaccggttcaggcagtgtatgattttgccaaatcactgctgaaagcattaaaagaagatggcgatgcagtgattgttgtgtttgatgccaaagccccgagctttcgtcatgaagcctatggcggctacaaagcaggtcgcgccccgaccccggaagattttccgcgtcagctggccttaattaaagaattagttgacttgctgggcttagcacgtctggaagttccgggctatgaagcagatgatgttttagcctcactggccaaaaaagccgaaaaagaaggctatgaagttcgcattctgaccgcagataaggatctgtatcagctgctgagcgatcgtattcatgtgttacatccggaaggctatctgattaccccggcatggttatgggaaaaatatggtttacgtccggatcagtgggcagattatcgtgcactgaccggtgacaaatcagataatctgccgggcgttaaaggtattggtgaaaaaaccgcccggaaattattagaagaatggggtagtctggaagcattactgaaaaatctggatcgcctgaaaccggcaattcgcgaaaaaattttagcccacatggatgacttaaaactgtcttgggatctggccaaagtgcgtaccgatctgccgttagaagttgattttgccaaacgtcgcgaaccggatcgtgaacgcctacgagcctttctggaacgcttagaatttggctcactgttacatgaatttggcttactggaatctccgaaagcattagaagaagccccgtggccgccgccggaaggcgcctttgtgggctttgtgctgagtaggaaagaaccgatgtgggcagacttgctggccctggccgcagcacgcggcggtcgcgttcatcgtgccccggaaccgtacaaagccctgcgtgacctgaaagaagcacgcggcttattagccaaagacctgagtgttctggcattaagggaaggcttaggcctgccgccgggcgatgatccgatgctgctggcctatctgcttgacccgagtaataccaccccggaaggcgttgcacgtcgctatggcggcgagtggaccgaagaagcaggcgaacgtgcagccctgtcagaacgtctgtttgccaatctgtggggtcgcttagaaggcgaagaacgcttactgtggttatatcgtgaagtggaacgtccgctgagcgcagtgctggcacacatggaagccaccggtgtgcgcttagatgttgcatatctgcgtgccctgtctctggaagttgcagaagaaattgcacgcttagaagccgaagtttttcgcttagcaggtcatccgtttaacttaaatagtcgcgatcagctggaaagggttctgtttgatgaattaggcctgccggcaattggcaagaccgaaaaaaccggtaaacgctctacctcagccgcagttctggaagccctgcgcgaagcccatccgattgttgaaaaaattttacagtatcgtgaactgaccaaactgaaatctacctatattgatccgttaccggatctaattcatccgcgtaccggtcgcttacatacccgttttaatcagaccgccaccgccaccggtcgcttatcaagtagccgtccgaacttgcagaatattccggtgcgtaccccgttaggtcagcgcattcgtcgtgcctttattgcagaagaaggttggttattagttgcattagattatagtcagattgaactgcgtgtgttagcccatctgagcggcgacgaaaatctgattcgtgtgtttcaggaaggtcgcgatattcataccgaaaccgcctcttggatgtttggtgttccgcgcgaagcagttgatccgttaatgcgccgtgcagccaaaaccattaattatggtgtgctgtatggtatgagcgcacatcgcctgtcacaggaactggcaattccgtatgaagaagcacaggcctttattgaacgctattttcagtcttttccgaaagttcgcgcatggattgaaaaaaccttagaagaaggtcgtcgtcgcggctatgtggaaaccctgtttggtcgtcgtcgctatgttccggatctggaagcgagagttaaatcagtgcgtgaagccgccgaacgcatggcctttaatatgccggttcagggaacggcagctgaccttatgaaactggcaatggttaaactgtttccgcgcctggaagaaatgggtgcacgaatgctgttacaggttcatgatgaattagttctggaagccccgaaagaacgcgccgaagcagttgcacgtctggccaaagaagtgatggaaggtgtgtatccgttagcagttccgttagaagtggaagtgggtattggtgaagattggctgagcgccaaagaaggttctggcagttcaggtcatcaccaccatcatcactaa

SEQ ID NO: 312 - protein, 844 aa, synthetic construct
  REGION 1..844: note = Description of Artificial Sequence: Synthetic polypeptide
MRGMLPLFEPKGRVLLVDGHHLAYRTFHALKGLTTSRGEPVQAVYDFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDKSDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSRPNLQNIPVRTPLGQRIRRAFIAEEGWLLVALDYSQIELRVLAHLSGDENLIRVFQEGRDIHTETASWMFGVPREAVDPLMRRAAKTINYGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKEGSGSSGHHHHHH

SEQ ID NO: 313 - DNA, 20 bp, synthetic construct
  misc_feature 1..20: note = Description of Artificial Sequence: Synthetic primer
  source 1..20: mol_type = other DNA
ccgctgcggtgagccttgaa

SEQ ID NO: 314 - DNA, 20 bp, synthetic construct
  misc_feature 1..20: note = Description of Artificial Sequence: Synthetic primer
  source 1..20: mol_type = other DNA
tctccgggatcggtcgcgtt

SEQ ID NO: 315 - protein, 12 aa, synthetic construct
  REGION 1..12: note = Description of Artificial Sequence: Synthetic peptide
GSGSSGHHHHHH

What is claimed is:

1. A mutant Taq polymerase comprising at least 90% amino acid sequence identity with the type Taq polymerase as shown in SEQ ID NO: 2 and comprising the mutation E9K relative to SEQ ID NO:2.

2. The mutant Taq DNA polymerase of claim 1 wherein the mutant Taq polymerase is capable of reverse transcribing mRNA to generate cDNA.

3. The mutant Taq DNA polymerase of claim 2 wherein the reverse transcribing mRNA to generate cDNA takes place at 38 or more amplification cycles.

4. The mutant Taq DNA polymerase of claim 2 wherein the reverse transcribing mRNA to generate cDNA takes place at a greater extent than performed by wild type Taq DNA polymerase under the same conditions.

5. A reverse transcription PCR process comprising: providing a reverse transcription PCR mixture including an RNA target, target sequence primers and the mutant Taq DNA polymerase of claim 1, subjecting the reverse transcription PCR mixture to PCR cycling conditions to generate cDNA and detecting the quantity of cDNA generated to quantitate the RNA target.

6. The method of claim 5 wherein the detection of the quantity of cDNA is by determining a quantity of reporter signal generated by an intercalating dye or by cleavage of a labeled target probe.

7. A reverse transcription qPCR process comprising: providing a reverse transcription qPCR mixture including an RNA target, target sequence primers, an intercalating dye or a labeled target probe which fluoresces when the label is cleaved from the probe by exonuclease activity, and the mutant Taq DNA polymerase of claim 1, providing a de-annealing temperature for a sufficient time to de-anneal primers from targets; providing a number of cycles of an annealing temperature followed by an extension temperature and determining the quantity of reporter signal generated by the intercalating dye or cleavage of the labeled target probe to quantify the amount of RNA target sequence present in the qPCR mixture.

8. The qPCR process of claim 7 wherein there are 38 or more cycles.

9. The qPCR process of claim 7 wherein the reporter signal is fluorescent.

10. The qPCR process of claim 7 wherein the intercalating dye is SYBR Green or EvaGreen.

* * * * *